United States Patent 12,569,549 (FLAVIVIRUS VACCINE) - sequence listing, part 29

SEQ ID NO: 11785 - RNA, 9876 nt, synthetic construct
  misc_feature 1..9876: note = derived and/or modified CDS sequence (opt2) from DENV-2__GU131928__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgtcgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11786 - RNA, 9876 nt, synthetic construct
  misc_feature 1..9876: note = derived and/or modified CDS sequence (opt2) from DENV-2__GU131929__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatccgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgtcgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctcttcaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11787 - RNA, 9876 nt, synthetic construct
  misc_feature 1..9876: note = derived and/or modified CDS sequence (opt2) from DENV-2__GU131930__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagtccaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcaccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11788 - RNA, 9876 nt, synthetic construct
  misc_feature 1..9876: note = derived and/or modified CDS sequence (opt2) from DENV-2__GU131931__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcccacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccagatcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11789 - RNA, 9876 nt, synthetic construct
  misc_feature 1..9876: note = derived and/or modified CDS sequence (opt2) from DENV-2__GU131932__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11790 - RNA, 9876 nt, synthetic construct
  misc_feature 1..9876: note = derived and/or modified CDS sequence (opt2) from DENV-2__GQ199892__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggcgccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcatcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacacccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11791 - RNA, 9876 nt, synthetic construct
  misc_feature 1..9876: note = derived and/or modified CDS sequence (opt2) from DENV-2__JF730044__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctcctccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatgggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccgtcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtcggcaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11792 - RNA, 9876 nt, synthetic construct
  misc_feature 1..9876: note = derived and/or modified CDS sequence (opt2) from DENV-2__FJ639697__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctcctccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatgggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccgtcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagctcgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtcggcaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcaccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11793 - RNA, 9876 nt, synthetic construct
  misc_feature 1..9876: note = derived and/or modified CDS sequence (opt2) from DENV-2__FJ639698__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttctcctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcatcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgaccccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagggcttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttctccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatctgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11794 - RNA, 9876 nt, synthetic construct
  misc_feature 1..9876: note = derived and/or modified CDS sequence (opt2) from DENV-2__FJ639699__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttctcctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcatcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagggcttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatgatcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatctgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagtacctcaccgtcaccgaggaggtcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11795 - RNA, 9876 nt, synthetic construct
  misc_feature 1..9876: note = derived and/or modified CDS sequence (opt2) from DENV-2__FJ639700__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttctcctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcatcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggccaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagggcttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatgatcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatctgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagtacctcaccgtcaccgaggaggtcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11796 - RNA, 9876 nt, synthetic construct
  misc_feature 1..9876: note = derived and/or modified CDS sequence (opt2) from DENV-2__GQ868620__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgtcgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacgccaacaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacgacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggtactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcatccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcgagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11797 - RNA, 9876 nt, synthetic construct
  misc_feature 1..9876: note = derived and/or modified CDS sequence (opt2) from DENV-2__FJ639702__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaggagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctcctccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatgggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccctcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctccaaggaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcgtcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccgtcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtcggcaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11798 - RNA, 9876 nt, synthetic construct
  misc_feature 1..9876: note = derived and/or modified CDS sequence (opt2) from DENV-2__GQ868621__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacatcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11799 - RNA, 9876 nt, synthetic construct
  misc_feature 1..9876: note = derived and/or modified CDS sequence (opt2) from DENV-2__FJ639704__SS-prME
  source 1..9876: mol_type = other RNA
tccgccggcatgatcatcatgctcatccccaccgtcgtcgccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaagaccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacatctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11800 - RNA, 9876 nt, synthetic construct
  misc_feature 1..9876: note = derived and/or modified CDS sequence (opt2) from DENV-2__GQ868622__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggcccgccagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggaccgccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11801 - RNA, 9876 nt, synthetic construct
  misc_feature 1..9876: note = derived and/or modified CDS sequence (opt2) from DENV-2__FJ639705__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggcccgccagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctctccctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11802 - RNA, 9876 nt, synthetic construct
  misc_feature 1..9876: note = derived and/or modified CDS sequence (opt2) from DENV-2__FJ639706__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgccctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11803 - RNA, 9876 nt, synthetic construct
  misc_feature 1..9876: note = derived and/or modified CDS sequence (opt2) from DENV-2__FJ639707__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacatcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgccgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgccaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgactcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcgtcggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11804 - RNA, 9876 nt, synthetic construct
  misc_feature 1..9876: note = derived and/or modified CDS sequence (opt2) from DENV-2__FJ639708__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacatcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11805 - RNA, 9876 nt, synthetic construct
  misc_feature 1..9876: note = derived and/or modified CDS sequence (opt2) from DENV-2__FJ639709__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagaccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggaacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11806 - RNA, 9876 nt, synthetic construct
  misc_feature 1..9876: note = derived and/or modified CDS sequence (opt2) from DENV-2__FJ639710__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcgccatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcatcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggccgccgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtggatcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacacctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatctacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11807 - RNA, 9876 nt, synthetic construct
  misc_feature 1..9876: note = derived and/or modified CDS sequence (opt2) from DENV-2__GQ868623__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcctcgccctcttcctcgaggagatgctccgcacccgcgtcggcaccaagcacgccatcctcctcgtcgccgtctccttcgtcaccctcatcaccggcaacatgtccgtcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcaccaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagcacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11808 - RNA, 9876 nt, synthetic construct
  misc_feature 1..9876: note = derived and/or modified CDS sequence (opt2) from DENV-2__GQ868624__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11809 - RNA, 9876 nt, synthetic construct
  misc_feature 1..9876: note = derived and/or modified CDS sequence (opt2) from DENV-2__FJ639717__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagtccaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcaccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11810 - RNA, 9876 nt, synthetic construct
  misc_feature 1..9876: note = derived and/or modified CDS sequence (opt2) from DENV-2__FJ639718__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11811 - RNA, 9876 nt, synthetic construct
  misc_feature 1..9876: note = derived and/or modified CDS sequence (opt2) from DENV-2__GQ868625__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccgcatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11812 - RNA, 9876 nt, synthetic construct
  misc_feature 1..9876: note = derived and/or modified CDS sequence (opt2) from DENV-2__KF955401__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgtcgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctcttcaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11813 - RNA, 9876 nt, synthetic construct
  misc_feature 1..9876: note = derived and/or modified CDS sequence (opt2) from DENV-2__JF730047__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagtccaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcaccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcatccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11814 - RNA, 9876 nt, synthetic construct
  misc_feature 1..9876: note = derived and/or modified CDS sequence (opt2) from DENV-2__JF730048__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagtccaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcaccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgactccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11815 - RNA, 9876 nt, synthetic construct
  misc_feature 1..9876: note = derived and/or modified CDS sequence (opt2) from DENV-2__KF955402__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgtcttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgtcgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaaggaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggccgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11816 - RNA, 9876 nt, synthetic construct
  misc_feature 1..9876: note = derived and/or modified CDS sequence (opt2) from DENV-2__FJ898460__SS-prME
  source 1..9876: mol_type = other RNA
accgccggcgtcatcgtcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttcaacggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatgcccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccgtccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11817 - RNA, 9876 nt, synthetic construct
  misc_feature 1..9876: note = derived and/or modified CDS sequence (opt2) from DENV-2__FJ882602__SS-prME
  source 1..9876: mol_type = other RNA
accgccggcatgatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtcgccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgacgacggctgctggtacggcatggagatccgccccctcaaggagaaggaggagaacctcgtcaactccctcgtcaccgccggctacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcgtcgtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgaggaggtcttcaagggcatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11818 - RNA, 9876 nt, synthetic construct
  misc_feature 1..9876: note = derived and/or modified CDS sequence (opt2) from DENV-2__GQ252676__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggagggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 11819 - RNA, 9876 nt, synthetic construct
  misc_feature 1..9876: note = derived and/or modified CDS sequence (opt2) from DENV-2__GQ252677__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggagggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctccgcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 11820 - RNA, 9876 nt, synthetic construct
  misc_feature 1..9876: note = derived and/or modified CDS sequence (opt2) from DENV-2__FJ898438__SS-prME
  source 1..9876: mol_type = other RNA
accgtcggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacttcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaactccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11821 - RNA, 9876 nt, synthetic construct
  misc_feature 1..9876: note = derived and/or modified CDS sequence (opt2) from DENV-2__GQ199893__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccaggtctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11822 - RNA, 9876 nt, synthetic construct
  misc_feature 1..9876: note = derived and/or modified CDS sequence (opt2) from DENV-2__GQ199894__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagcacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccaggtctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11823 - RNA, 9876 nt, synthetic construct
  misc_feature 1..9876: note = derived and/or modified CDS sequence (opt2) from DENV-2__FJ898439__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgagaccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcgtcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagcgcaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggaggtcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11824 - RNA, 9876 nt, synthetic construct
  misc_feature 1..9876: note = derived and/or modified CDS sequence (opt2) from DENV-2__GQ868588__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccctcgacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttccgcaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacctccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaacttcgccggccccgtctcccagcacaacaaccgccccggctaccacacccagaccgccggcccctggcacctcggcaagctcgagatggacttcgacttctgcgagggcaccaccgtcgtcgtcaccgaggagtgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacatcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagaagtacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgcctccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggccacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcatctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgcctccgaggagatcgccgtccaggactggctcgtccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11825 - RNA, 9876 nt, synthetic construct
  misc_feature 1..9876: note = derived and/or modified CDS sequence (opt2) from DENV-2__GQ868590__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcatgttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggtcggcaagcgctccctccgcccccagcccaccgagctccgctactcctggaagacctggggcaaggccaagatgctccccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaacctcgccggccccgtctcccagcacaacaaccgccccggctaccacacccagaccgccggcccctggcacctcggcaagctcgagatggacttcaacttctgcgagggcaccaccgtcgtcgtcaccgaggagtgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgcctacaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagaagtacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcggccccgagcgcgagaaggtcgacgccatcgacggcgagtaccgcctccgcggcgaggcccgcaagaccttcgtcgagctcatgcgccgcggcgacctccccgtctggctcgcctacaaggtcgcctccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggccacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagtcctggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacgtcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccacccccatcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgcctccgaggagatcgccgtccaggactggctcgtccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11826 - RNA, 9876 nt, synthetic construct
  misc_feature 1..9876: note = derived and/or modified CDS sequence (opt2) from DENV-2__GQ868497__SS-prME
  source 1..9876: mol_type = other RNA
accgcctccgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcatgcagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccgtcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcgcgagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11827 - RNA, 9876 nt, synthetic construct
  misc_feature 1..9876: note = derived and/or modified CDS sequence (opt2) from DENV-2__GU131959__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaacacccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgagacctggaagatggagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11828 - RNA, 9876 nt, synthetic construct
  misc_feature 1..9876: note = derived and/or modified CDS sequence (opt2) from DENV-2__GQ868515__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctggatcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccgctacgagggcgacggctccccctgcaagatccccttcgagatcaccgactccgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcatcctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagaacatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11829 - RNA, 9876 nt, synthetic construct
  misc_feature 1..9876: note = derived and/or modified CDS sequence (opt2) from DENV-2__GQ868516__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctggatcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcatcctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagaacatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11830 - RNA, 9876 nt, synthetic construct
  misc_feature 1..9876: note = derived and/or modified CDS sequence (opt2) from DENV-2__GU131975__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctggatcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcatcctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgctccctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagaacatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11831 - RNA, 9876 nt, synthetic construct
  misc_feature 1..9876: note = derived and/or modified CDS sequence (opt2) from DENV-2__JN819422__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagacccagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccaggtctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11832 - RNA, 9876 nt, synthetic construct
  misc_feature 1..9876: note = derived and/or modified CDS sequence (opt2) from DENV-2__GU131955__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11833 - RNA, 9876 nt, synthetic construct
  misc_feature 1..9876: note = derived and/or modified CDS sequence (opt2) from DENV-2__KJ189311__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctggatcacctacggcacctgctccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcatcctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagtccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaacctcgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgctccctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagaacatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11834 - RNA, 9876 nt, synthetic construct
  misc_feature 1..9876: note = derived and/or modified CDS sequence (opt2) from DENV-2__KJ189370__SS-prME
  source 1..9876: mol_type = other RNA
accgccggcgtcatcgtcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaaggtcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagtacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcctcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgtccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11835 - RNA, 9876 nt, synthetic construct
  misc_feature 1..9876: note = derived and/or modified CDS sequence (opt2) from DENV-2__EU482620__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11836 - RNA, 9876 nt, synthetic construct
  misc_feature 1..9876: note = derived and/or modified CDS sequence (opt2) from DENV-2__FJ373300__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcaccatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccgtcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11837 - RNA, 9876 nt, synthetic construct
  misc_feature 1..9876: note = derived and/or modified CDS sequence (opt2) from DENV-2__EU596495__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11838 - RNA, 9876 nt, synthetic construct
  misc_feature 1..9876: note = derived and/or modified CDS sequence (opt2) from DENV-2__EU596497__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccatcaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcctacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11839 - RNA, 9876 nt, synthetic construct
  misc_feature 1..9876: note = derived and/or modified CDS sequence (opt2) from DENV-2__EU569695__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccgtcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11840 - RNA, 9876 nt, synthetic construct
  misc_feature 1..9876: note = derived and/or modified CDS sequence (opt2) from DENV-2__EU482623__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcctcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaactccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccatcgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11841 - RNA, 9876 nt, synthetic construct
  misc_feature 1..9876: note = derived and/or modified CDS sequence (opt2) from DENV-2__EU569698__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgactccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11842 - RNA, 9876 nt, synthetic construct
  misc_feature 1..9876: note = derived and/or modified CDS sequence (opt2) from DENV-2__EU569699__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccaagttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgacaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcctcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccatcgaggagatcgccgtccagaactggctcgcccgcgtcggccgcgagcgcctctcccgcatggccatctccggcgacgactgcgtcatcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11843 - RNA, 9876 nt, synthetic construct
  misc_feature 1..9876: note = derived and/or modified CDS sequence (opt2) from DENV-2__KF955366__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccacctcccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11844 - RNA, 9876 nt, synthetic construct
  misc_feature 1..9876: note = derived and/or modified CDS sequence (opt2) from DENV-2__EU569700__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11845 - RNA, 9876 nt, synthetic construct
  misc_feature 1..9876: note = derived and/or modified CDS sequence (opt2) from DENV-2__KF955369__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccaccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11846 - RNA, 9876 nt, synthetic construct
  misc_feature 1..9876: note = derived and/or modified CDS sequence (opt2) from DENV-2__EU569702__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagcgcgcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgactccgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11847 - RNA, 9876 nt, synthetic construct
  misc_feature 1..9876: note = derived and/or modified CDS sequence (opt2) from DENV-2__EU482624__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgccaacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11848 - RNA, 9876 nt, synthetic construct
  misc_feature 1..9876: note = derived and/or modified CDS sequence (opt2) from DENV-2__EU596500__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagtccatcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcttcgccatcggctgctactaccaggtcaaccccatcaccctcaccgccgccctcctcctcctcgtcgcccacaacgccatcatcggccagggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11849 - RNA, 9876 nt, synthetic construct
  misc_feature 1..9876: note = derived and/or modified CDS sequence (opt2) from DENV-2__EU482626__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccacccagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11850 - RNA, 9876 nt, synthetic construct
  misc_feature 1..9876: note = derived and/or modified CDS sequence (opt2) from DENV-2__EU482629__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttcaaggacctcggccgcgtcatggtcatgatgggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaagatccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11851 - RNA, 9876 nt, synthetic construct
  misc_feature 1..9876: note = derived and/or modified CDS sequence (opt2) from DENV-2__FJ390390__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccaagttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgacaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcctcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11852 - RNA, 9876 nt, synthetic construct
  misc_feature 1..9876: note = derived and/or modified CDS sequence (opt2) from DENV-2__FJ390391__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcttcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11853 - RNA, 9876 nt, synthetic construct
  misc_feature 1..9876: note = derived and/or modified CDS sequence (opt2) from DENV-2__FJ882593__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11854 - RNA, 9876 nt, synthetic construct
  misc_feature 1..9876: note = derived and/or modified CDS sequence (opt2) from DENV-2__FJ182014__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccttcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcatcatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11855 - RNA, 9876 nt, synthetic construct
  misc_feature 1..9876: note = derived and/or modified CDS sequence (opt2) from DENV-2__FJ547090__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccaccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgcctcggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11856 - RNA, 9876 nt, synthetic construct
  misc_feature 1..9876: note = derived and/or modified CDS sequence (opt2) from DENV-2__EU482630__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccttcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11857 - RNA, 9876 nt, synthetic construct
  misc_feature 1..9876: note = derived and/or modified CDS sequence (opt2) from DENV-2__FJ882594__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaacatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11858 - RNA, 9876 nt, synthetic construct
  misc_feature 1..9876: note = derived and/or modified CDS sequence (opt2) from DENV-2__FJ205885__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcctcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11859 - RNA, 9876 nt, synthetic construct
  misc_feature 1..9876: note = derived and/or modified CDS sequence (opt2) from DENV-2__FJ744743__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctctggccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccgtcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccaccctcctccgcttcgtcgcccagtacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccatcgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11860 - RNA, 9876 nt, synthetic construct
  misc_feature 1..9876: note = derived and/or modified CDS sequence (opt2) from DENV-2__JN819424__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgcctcctccatcgacaaccgcgccgtccacgccgacatgggctactggatggagtccgccccctccgactcctgcaagatggagaaggcctccttcatcgaggacaagtcctgctactggcccaactcccagcacctctggtccaacggcgtcctcgagtccgagatgatcttccccaagaacttcgccggccccgtctcccagcacatctaccgccccggctaccacacccagaccgccggcccctgcaacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgaggccatcgacggcgagtaccgcctccgcggcgaggcccgcaagaccttcgtcgacctcatgcgccgcggcgacctccccgtccgcctcgcctacaaggtcgccgccgagggcatcaactacgccgaccgcaagtggtgcttcgacggcatcaagaactcccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11861 - RNA, 9876 nt, synthetic construct
  misc_feature 1..9876: note = derived and/or modified CDS sequence (opt2) from DENV-2__FJ744741__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggcgcgtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11862 - RNA, 9876 nt, synthetic construct
  misc_feature 1..9876: note = derived and/or modified CDS sequence (opt2) from DENV-2__FJ744703__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcaccgacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcccctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggccgcgccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11863 - RNA, 9876 nt, synthetic construct
  misc_feature 1..9876: note = derived and/or modified CDS sequence (opt2) from DENV-2__FJ850067__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccctcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaccatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgagaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaagatccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11864 - RNA, 9876 nt, synthetic construct
  misc_feature 1..9876: note = derived and/or modified CDS sequence (opt2) from DENV-2__FJ850060__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcgccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatccgcaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggcaagctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccagggcaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11865 - RNA, 9876 nt, synthetic construct
  misc_feature 1..9876: note = derived and/or modified CDS sequence (opt2) from DENV-2__FJ850061__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgccaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaagcccatcaccttcaccgccgccctcctcctcctcgtcgcccactacgccatcatcggccccggcctccaggccaaggccccccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11866 - RNA, 9876 nt, synthetic construct
  misc_feature 1..9876: note = derived and/or modified CDS sequence (opt2) from DENV-2__FJ744709__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccgtcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcatcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggccgcaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11867 - RNA, 9876 nt, synthetic construct
  misc_feature 1..9876: note = derived and/or modified CDS sequence (opt2) from DENV-2__FJ744708__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgccgagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggtcaacatcttctccggctcctacctcgccggcgccggcctccacgtccccctccgcaagaacaccctccgcacccgccgcggcaccggcaacaccggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11868 - RNA, 9876 nt, synthetic construct
  misc_feature 1..9876: note = derived and/or modified CDS sequence (opt2) from DENV-2__FJ810418__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcaagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgtcgagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11869 - RNA, 9876 nt, synthetic construct
  misc_feature 1..9876: note = derived and/or modified CDS sequence (opt2) from DENV-2__FJ639835__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagtccatcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11870 - RNA, 9876 nt, synthetic construct
  misc_feature 1..9876: note = derived and/or modified CDS sequence (opt2) from DENV-2__FJ850050__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcggcaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaagtacaaccgcgccgtccacgccgacatgggctactggatcgagtccgccccctgcgactcctgggagatgcagaaggcctccttcatcgaggtcatctcctgccactggcccaagtccctcaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatgcaggagcagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11871 - RNA, 9876 nt, synthetic construct
  misc_feature 1..9876: note = derived and/or modified CDS sequence (opt2) from DENV-2__FJ639837__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagtccatcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgcccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcgccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11872 - RNA, 9876 nt, synthetic construct
  misc_feature 1..9876: note = derived and/or modified CDS sequence (opt2) from DENV-2__FJ744706__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccggctcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgcggcaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11873 - RNA, 9876 nt, synthetic construct
  misc_feature 1..9876: note = derived and/or modified CDS sequence (opt2) from DENV-2__FJ744707__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgccccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11874 - RNA, 9876 nt, synthetic construct
  misc_feature 1..9876: note = derived and/or modified CDS sequence (opt2) from DENV-2__FJ744704__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatgttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatctgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11875 - RNA, 9876 nt, synthetic construct
  misc_feature 1..9876: note = derived and/or modified CDS sequence (opt2) from DENV-2__FJ744745__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctcaagatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccaccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11876 - RNA, 9876 nt, synthetic construct
  misc_feature 1..9876: note = derived and/or modified CDS sequence (opt2) from DENV-2__FJ744705__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacgactccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgtcgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11877 - RNA, 9876 nt, synthetic construct
  misc_feature 1..9876: note = derived and/or modified CDS sequence (opt2) from DENV-2__FJ744744__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctcaagatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgtcggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgagaactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11878 - RNA, 9876 nt, synthetic construct
  misc_feature 1..9876: note = derived and/or modified CDS sequence (opt2) from DENV-2__GQ868646__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccaagttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgacaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcctcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11879 - RNA, 9876 nt, synthetic construct
  misc_feature 1..9876: note = derived and/or modified CDS sequence (opt2) from DENV-2__FJ906961__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggaggtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11880 - RNA, 9876 nt, synthetic construct
  misc_feature 1..9876: note = derived and/or modified CDS sequence (opt2) from DENV-2__FJ906962__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgagatcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaacatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatcgaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11881 - RNA, 9876 nt, synthetic construct
  misc_feature 1..9876: note = derived and/or modified CDS sequence (opt2) from DENV-2__FJ850053__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11882 - RNA, 9876 nt, synthetic construct
  misc_feature 1..9876: note = derived and/or modified CDS sequence (opt2) from DENV-2__JN819420__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagcgcgcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgactccgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatgggctgctactcccagttcaagcccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11883 - RNA, 9876 nt, synthetic construct
  misc_feature 1..9876: note = derived and/or modified CDS sequence (opt2) from DENV-2__FJ850118__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggctacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11884 - RNA, 9876 nt, synthetic construct
  misc_feature 1..9876: note = derived and/or modified CDS sequence (opt2) from DENV-2__JN819416__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11885 - RNA, 9876 nt, synthetic construct
  misc_feature 1..9876: note = derived and/or modified CDS sequence (opt2) from DENV-2__FJ850119__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcatcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgcctccgaggagaccgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11886 - RNA, 9876 nt, synthetic construct
  misc_feature 1..9876: note = derived and/or modified CDS sequence (opt2) from DENV-2__FJ850064__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgccaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11887 - RNA, 9876 nt, synthetic construct
  misc_feature 1..9876: note = derived and/or modified CDS sequence (opt2) from DENV-2__FJ850065__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcaccgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggaggacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagcacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11888 - RNA, 9876 nt, synthetic construct
  misc_feature 1..9876: note = derived and/or modified CDS sequence (opt2) from DENV-2__FJ873808__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcgccatcctcgccgccgtctccgtctcccccctcctcctcacctcctccaagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatccgcaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggcaagctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccagggcaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11889 - RNA, 9876 nt, synthetic construct
  misc_feature 1..9876: note = derived and/or modified CDS sequence (opt2) from DENV-2__FJ850120__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccgtcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccaagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagaacatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggctccatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11890 - RNA, 9876 nt, synthetic construct
  misc_feature 1..9876: note = derived and/or modified CDS sequence (opt2) from DENV-2__FJ850121__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgtcaccctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11891 - RNA, 9876 nt, synthetic construct
  misc_feature 1..9876: note = derived and/or modified CDS sequence (opt2) from DENV-2__GQ199897__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcgtctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11892 - RNA, 9876 nt, synthetic construct
  misc_feature 1..9876: note = derived and/or modified CDS sequence (opt2) from DENV-2__GQ199895__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggaggacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtccccccccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11893 - RNA, 9876 nt, synthetic construct
  misc_feature 1..9876: note = derived and/or modified CDS sequence (opt2) from DENV-2__FJ898478__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11894 - RNA, 9876 nt, synthetic construct
  misc_feature 1..9876: note = derived and/or modified CDS sequence (opt2) from DENV-2__GQ199869__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11895 - RNA, 9876 nt, synthetic construct
  misc_feature 1..9876: note = derived and/or modified CDS sequence (opt2) from DENV-2__JX079688__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcatcgaggagtacaccgactacatgccctccatgaagcgcttccgccgcgaggaggaggaggccggcgtcctctggtga

SEQ ID NO: 11896 - RNA, 9876 nt, synthetic construct
  misc_feature 1..9876: note = derived and/or modified CDS sequence (opt2) from DENV-2__JF357906__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccgtcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcatcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggccgcaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtacatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11897 - RNA, 9873 nt, synthetic construct
  misc_feature 1..9873: note = derived and/or modified CDS sequence (opt2) from DENV-2__HQ705624__SS-prME
  source 1..9873: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccaagttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaaggtccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatcaagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgacaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcctcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11898 - RNA, 9876 nt, synthetic construct
  misc_feature 1..9876: note = derived and/or modified CDS sequence (opt2) from DENV-2__HQ705625__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatgaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcaccaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11899 - RNA, 9876 nt, synthetic construct
  misc_feature 1..9876: note = derived and/or modified CDS sequence (opt2) from DENV-2__JF730052__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatgaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcaccaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcaccaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11900 - RNA, 9876 nt, synthetic construct
  misc_feature 1..9876: note = derived and/or modified CDS sequence (opt2) from DENV-2__EU482748__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggagaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaagaccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgtcgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11901 - RNA, 9876 nt, synthetic construct
  misc_feature 1..9876: note = derived and/or modified CDS sequence (opt2) from DENV-2__EU482749__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagaccatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctctccgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaagatccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11902 - RNA, 9876 nt, synthetic construct
  misc_feature 1..9876: note = derived and/or modified CDS sequence (opt2) from DENV-2__EU482751__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11903 - RNA, 9876 nt, synthetic construct
  misc_feature 1..9876: note = derived and/or modified CDS sequence (opt2) from DENV-2__GQ868604__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccgcggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaacatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11904 - RNA, 9876 nt, synthetic construct
  misc_feature 1..9876: note = derived and/or modified CDS sequence (opt2) from DENV-2__EU482752__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaacatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11905 - RNA, 9876 nt, synthetic construct
  misc_feature 1..9876: note = derived and/or modified CDS sequence (opt2) from DENV-2__EU482753__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccatgatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11906 - RNA, 9876 nt, synthetic construct
  misc_feature 1..9876: note = derived and/or modified CDS sequence (opt2) from DENV-2__EU482680__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcaccggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagaagcccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11907 - RNA, 9876 nt, synthetic construct
  misc_feature 1..9876: note = derived and/or modified CDS sequence (opt2) from DENV-2__EU482754__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacatccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11908 - RNA, 9876 nt, synthetic construct
  misc_feature 1..9876: note = derived and/or modified CDS sequence (opt2) from DENV-2__FJ478455__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgtcgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11909 - RNA, 9876 nt, synthetic construct
  misc_feature 1..9876: note = derived and/or modified CDS sequence (opt2) from DENV-2__EU482756__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagtacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11910 - RNA, 9876 nt, synthetic construct
  misc_feature 1..9876: note = derived and/or modified CDS sequence (opt2) from DENV-2__EU482757__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgtcgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11911 - RNA, 9876 nt, synthetic construct
  misc_feature 1..9876: note = derived and/or modified CDS sequence (opt2) from DENV-2__FJ906956__SS-prME
  source 1..9876: mol_type = other RNA
accgccggcgtcatcgtcatgctcatccccaccgccatggccttccacctcaccacccgcaacggcgagccccacatgatcgtcggcaagcaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagcgcgtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaaccacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11912 - RNA, 9876 nt, synthetic construct
  misc_feature 1..9876: note = derived and/or modified CDS sequence (opt2) from DENV-2__EU482759__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcggcgccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11913 - RNA, 9876 nt, synthetic construct
  misc_feature 1..9876: note = derived and/or modified CDS sequence (opt2) from DENV-2__EU482760__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcgccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaagatccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11914 - RNA, 9876 nt, synthetic construct
  misc_feature 1..9876: note = derived and/or modified CDS sequence (opt2) from DENV-2__EU482762__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11915 - RNA, 9876 nt, synthetic construct
  misc_feature 1..9876: note = derived and/or modified CDS sequence (opt2) from DENV-2__EU482763__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11916 - RNA, 9876 nt, synthetic construct
  misc_feature 1..9876: note = derived and/or modified CDS sequence (opt2) from DENV-2__EU482444__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccatccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgtcatgtacgccgacgacaccgccggctgggacacccgcatcaccctcgaggacctcaagaacgaggagctcgtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11917 - RNA, 9876 nt, synthetic construct
  misc_feature 1..9876: note = derived and/or modified CDS sequence (opt2) from DENV-2__EU482684__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccaccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11918 - RNA, 9876 nt, synthetic construct
  misc_feature 1..9876: note = derived and/or modified CDS sequence (opt2) from DENV-2__EU482685__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggcaacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgccaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11919 - RNA, 9876 nt, synthetic construct
  misc_feature 1..9876: note = derived and/or modified CDS sequence (opt2) from DENV-2__EU482687__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccgtcctcgcctacaccatcggcaccacccacttccagcgcgccctcatcttcgtcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatgaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11920 - RNA, 9876 nt, synthetic construct
  misc_feature 1..9876: note = derived and/or modified CDS sequence (opt2) from DENV-2__EU482688__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccctcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcatcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccatgatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11921 - RNA, 9876 nt, synthetic construct
  misc_feature 1..9876: note = derived and/or modified CDS sequence (opt2) from DENV-2__EU482691__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacatcaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11922 - RNA, 9876 nt, synthetic construct
  misc_feature 1..9876: note = derived and/or modified CDS sequence (opt2) from DENV-2__EU482693__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccaccctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccgccgaggagaacgtcgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11923 - RNA, 9876 nt, synthetic construct
  misc_feature 1..9876: note = derived and/or modified CDS sequence (opt2) from DENV-2__EU596483__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatggagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacaccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggagaccggcgtcctctggtga

SEQ ID NO: 11924 - RNA, 9876 nt, synthetic construct
  misc_feature 1..9876: note = derived and/or modified CDS sequence (opt2) from DENV-2__EU482597__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctctccgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaagatccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11925 - RNA, 9876 nt, synthetic construct
  misc_feature 1..9876: note = derived and/or modified CDS sequence (opt2) from DENV-2__EU482598__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11926 - RNA, 9876 nt, synthetic construct
  misc_feature 1..9876: note = derived and/or modified CDS sequence (opt2) from DENV-2__EU482603__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgccgagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcgacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaagaccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgtcgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11927 - RNA, 9876 nt, synthetic construct
  misc_feature 1..9876: note = derived and/or modified CDS sequence (opt2) from DENV-2__EU482599__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggtcatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11928 - RNA, 9876 nt, synthetic construct
  misc_feature 1..9876: note = derived and/or modified CDS sequence (opt2) from DENV-2__FJ898436__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgcctggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11929 - RNA, 9876 nt, synthetic construct
  misc_feature 1..9876: note = derived and/or modified CDS sequence (opt2) from DENV-2__EU482634__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacaccaagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgtcgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11930 - RNA, 9876 nt, synthetic construct
  misc_feature 1..9876: note = derived and/or modified CDS sequence (opt2) from DENV-2__EU482635__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctctccgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11931 - RNA, 9876 nt, synthetic construct
  misc_feature 1..9876: note = derived and/or modified CDS sequence (opt2) from DENV-2__GQ199874__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11932 - RNA, 9876 nt, synthetic construct
  misc_feature 1..9876: note = derived and/or modified CDS sequence (opt2) from DENV-2__EU482639__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccctcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgagaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaagatccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11933 - RNA, 9876 nt, synthetic construct
  misc_feature 1..9876: note = derived and/or modified CDS sequence (opt2) from DENV-2__EU482766__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctcctcccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgccagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11934 - RNA, 9876 nt, synthetic construct
  misc_feature 1..9876: note = derived and/or modified CDS sequence (opt2) from DENV-2__EU482695__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11935 - RNA, 9876 nt, synthetic construct
  misc_feature 1..9876: note = derived and/or modified CDS sequence (opt2) from DENV-2__EU482769__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagaccaccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccatgatcggcctcacctcccgcgccacctgggccaagaacatccagaccgccatcaaccaggtccgctccctcatcggcaacgaggagtacatcgactacatgccctccatgaagcgcttccgccgcgaggaggaggaggccggcgtcctctggtga

SEQ ID NO: 11936 - RNA, 9876 nt, synthetic construct
  misc_feature 1..9876: note = derived and/or modified CDS sequence (opt2) from DENV-2__EU482696__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgcctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccaccctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcaccttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaagaccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcatcgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccgccgaggagatcgtcgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11937 - RNA, 9876 nt, synthetic construct
  misc_feature 1..9876: note = derived and/or modified CDS sequence (opt2) from DENV-2__KC294207__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactgcatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggccccggccacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11938 - RNA, 9876 nt, synthetic construct
  misc_feature 1..9876: note = derived and/or modified CDS sequence (opt2) from DENV-2__KC294208__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcgaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11939 - RNA, 9876 nt, synthetic construct
  misc_feature 1..9876: note = derived and/or modified CDS sequence (opt2) from DENV-2__KC294209__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11940 - RNA, 9876 nt, synthetic construct
  misc_feature 1..9876: note = derived and/or modified CDS sequence (opt2) from DENV-2__KC294214__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggcgcaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccaccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11941 - RNA, 9876 nt, synthetic construct
  misc_feature 1..9876: note = derived and/or modified CDS sequence (opt2) from DENV-2__KC294205__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccaccagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaccaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11942 - RNA, 9876 nt, synthetic construct
  misc_feature 1..9876: note = derived and/or modified CDS sequence (opt2) from DENV-2__KC294210__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcatgatggagtcctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgtccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11943 - RNA, 9876 nt, synthetic construct
  misc_feature 1..9876: note = derived and/or modified CDS sequence (opt2) from DENV-2__KC294215__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11944 - RNA, 9876 nt, synthetic construct
  misc_feature 1..9876: note = derived and/or modified CDS sequence (opt2) from DENV-2__KC294216__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacctcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcctcaccctcatcaccggcaacatgtccttccgcgacctcggccgcgtcatggtcatggtcggcgtcgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccacccccgagaccatcctcgagctcaccgacgccctcgccctcggcatgatggtcctcaagatcgtccgcaacatggagaagtaccagctcgccgtcaccatcatgaccatctcctgcgtccccaacgccatgatcctcatcaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtccgcaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagcgcgacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgccatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccgtcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11945 - RNA, 9876 nt, synthetic construct
  misc_feature 1..9876: note = derived and/or modified CDS sequence (opt2) from DENV-2__KC294218__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcctcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11946 - RNA, 9876 nt, synthetic construct
  misc_feature 1..9876: note = derived and/or modified CDS sequence (opt2) from DENV-2__KC294220__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagatgtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11947 - RNA, 9876 nt, synthetic construct
  misc_feature 1..9876: note = derived and/or modified CDS sequence (opt2) from DENV-2__KC294221__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcgcggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11948 - RNA, 9876 nt, synthetic construct
  misc_feature 1..9876: note = derived and/or modified CDS sequence (opt2) from DENV-2__KC294223__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcgtcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgtcgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 11949 - RNA, 9876 nt, synthetic construct
  misc_feature 1..9876: note = derived and/or modified CDS sequence (opt2) from DENV-2__FJ906959__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgatcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggatcatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccagccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11950 - RNA, 9876 nt, synthetic construct
  misc_feature 1..9876: note = derived and/or modified CDS sequence (opt2) from DENV-2__KF360005__SS-prME
  source 1..9876: mol_type = other RNA
accgccggcgtcatcatcatgcgcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcggccgcggctggggcgacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccctccacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcatccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgaggtctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctccgccgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggccgcaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcgcctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgccgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggctcccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtccgcggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccgtcgtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccgtctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgctcctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcggcctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcggcgaccagtggtgcggctccctcatcggcctcacctcccgcgccacctgggcccgcaacatccagaccgccatcaaccgcgtccgctccctcatcggctccgagggctacaccgactacatgccctccatgaagcgcttccgccgcgaggaggacgaggccggcgtcctctggtga

SEQ ID NO: 11951 - RNA, 9876 nt, synthetic construct
  misc_feature 1..9876: note = derived and/or modified CDS sequence (opt2) from DENV-2__KJ010185__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaacgccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaaccccctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcatccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcttcaccgacaacgtccacacctggaccgagcagtacaagttccagcccgagtccccctccaagctcgcctccgccatccagaaggcccacgaggagggcatctgcggcatccgctccatcacccgcctcgacaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgcccagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggcctcccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcgtctccctcctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctcctcaccggcgccgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgaccccgacgtcgacctcggctccggcacccgcaacatcggcatcgagtccgagacccccaacctcgacatcatcggcaagcgcatcgagaagatcaagcaggagcacgagacctcccgccactacgaccaggaccacccctacaagacctgggcctaccacggctcctacgagaccaagcagaccggctccgcctcctccaccgtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccgtccaggtcggcacctacggcctcggcaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccggccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttcggccgcgaggaggaggaggccggcgtcctctggtga

SEQ ID NO: 11952 - RNA, 9876 nt, synthetic construct
  misc_feature 1..9876: note = derived and/or modified CDS sequence (opt2) from DENV-2__KJ010186__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaacgccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggcccgcctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaagccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaccgccctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcctccaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtccgctcctacccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 11953 - RNA, 9876 nt, synthetic construct
  misc_feature 1..9876: note = derived and/or modified CDS sequence (opt2) from DENV-2__KF955364__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacggcgtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcctctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagtacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11954 - RNA, 9876 nt, synthetic construct
  misc_feature 1..9876: note = derived and/or modified CDS sequence (opt2) from DENV-2__KF955372__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagtacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacgtcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccaccgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11955 - RNA, 9876 nt, synthetic construct
  misc_feature 1..9876: note = derived and/or modified CDS sequence (opt2) from DENV-2__KF955373__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccctctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11956 - RNA, 9876 nt, synthetic construct
  misc_feature 1..9876: note = derived and/or modified CDS sequence (opt2) from DENV-2__GQ868600__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacctccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaacttcgccggccccgtctcccagcacaacaaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggcaacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgcctccgaggagatcgccgtccaggactggctcgtccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaacaaggtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11957 - RNA, 9876 nt, synthetic construct
  misc_feature 1..9876: note = derived and/or modified CDS sequence (opt2) from DENV-2__KF955359__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccaccatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccatcctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgcctccctcgtcctcgtcggcatcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11958 - RNA, 9876 nt, synthetic construct
  misc_feature 1..9876: note = derived and/or modified CDS sequence (opt2) from DENV-2__KF955360__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcgccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11959 - RNA, 9876 nt, synthetic construct
  misc_feature 1..9876: note = derived and/or modified CDS sequence (opt2) from DENV-2__KF955363__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcaggtcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggtcatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11960 - RNA, 9876 nt, synthetic construct
  misc_feature 1..9876: note = derived and/or modified CDS sequence (opt2) from DENV-2__EU726767__SS-prME
  source 1..9876: mol_type = other RNA
tccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcgccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacgtcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttcaaggacctcggccgcgtcgtcgtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgccctcctctcccagtccaccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgtcacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccgtcttcaccgacgagaacaagtggaagtccgcccgcgaggccgtcgaggactcccgcttctgggagctcgtcgacaaggagcgctccctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11961 - RNA, 9876 nt, synthetic construct
  misc_feature 1..9876: note = derived and/or modified CDS sequence (opt2) from DENV-2__EU687246__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaacatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggctccgaggagtacaccgactacatgccctccatgaagcgcttccgccgcgaggaggaggaggccggcgtcctctggtga

SEQ ID NO: 11962 - RNA, 9876 nt, synthetic construct
  misc_feature 1..9876: note = derived and/or modified CDS sequence (opt2) from DENV-2__FJ639828__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcaccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgccaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcttcctccgcaagctcacctccaaggagctcatgatgaccaccatcggcatcgtcctcctctcccagtccaccctccccgagaccatcctcgagctcaccgacgccctcgccctcggcatgatggtcctcaagatggtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcacccacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaactcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11963 - RNA, 9876 nt, synthetic construct
  misc_feature 1..9876: note = derived and/or modified CDS sequence (opt2) from DENV-2__FJ639829__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcaccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcttcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcacccacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaactcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 11964 - RNA, 9876 nt, synthetic construct
  misc_feature 1..9876: note = derived and/or modified CDS sequence (opt2) from DENV-2__FJ639831__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatcgtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccgtcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgtcgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcgtcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccatgtgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaagaccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaagctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatctacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11965 - RNA, 9876 nt, synthetic construct
  misc_feature 1..9876: note = derived and/or modified CDS sequence (opt2) from DENV-2__FJ639832__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11966 - RNA, 9876 nt, synthetic construct
  misc_feature 1..9876: note = derived and/or modified CDS sequence (opt2) from DENV-2__FJ687434__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcaccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggcccgcctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcacctccctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggccatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaactcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11967 - RNA, 9876 nt, synthetic construct
  misc_feature 1..9876: note = derived and/or modified CDS sequence (opt2) from DENV-2__FJ687439__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgccaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcgtcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacatctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11968 - RNA, 9876 nt, synthetic construct
  misc_feature 1..9876: note = derived and/or modified CDS sequence (opt2) from DENV-2__FJ687440__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctggatcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaccggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11969 - RNA, 9876 nt, synthetic construct
  misc_feature 1..9876: note = derived and/or modified CDS sequence (opt2) from DENV-2__FJ687441__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctggatcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggagatcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11970 - RNA, 9876 nt, synthetic construct
  misc_feature 1..9876: note = derived and/or modified CDS sequence (opt2) from DENV-2__FJ687445__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcaccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcttcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcacccacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccccacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaactcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 11971 - RNA, 9876 nt, synthetic construct
  misc_feature 1..9876: note = derived and/or modified CDS sequence (opt2) from DENV-2__FJ687447__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcacctccctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgccttcaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11972 - RNA, 9876 nt, synthetic construct
  misc_feature 1..9876: note = derived and/or modified CDS sequence (opt2) from DENV-2__FJ810411__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcacctccctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgccttcaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11973 - RNA, 9876 nt, synthetic construct
  misc_feature 1..9876: note = derived and/or modified CDS sequence (opt2) from DENV-2__FJ744713__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcacctccctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagatcctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgccttcaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11974 - RNA, 9876 nt, synthetic construct
  misc_feature 1..9876: note = derived and/or modified CDS sequence (opt2) from DENV-2__FJ744714__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagcgcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11975 - RNA, 9876 nt, synthetic construct
  misc_feature 1..9876: note = derived and/or modified CDS sequence (opt2) from DENV-2__FJ744716__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagcgcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccgcaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11976 - RNA, 9876 nt, synthetic construct
  misc_feature 1..9876: note = derived and/or modified CDS sequence (opt2) from DENV-2__FJ744718__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggctcccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11977 - RNA, 9876 nt, synthetic construct
  misc_feature 1..9876: note = derived and/or modified CDS sequence (opt2) from DENV-2__FJ744722__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcaccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagcccaacctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcttcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcacccacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaactcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 11978 - RNA, 9876 nt, synthetic construct
  misc_feature 1..9876: note = derived and/or modified CDS sequence (opt2) from DENV-2__FJ744723__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcaccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcttcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcacccacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgcccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaactcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagaccgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 11979 - RNA, 9876 nt, synthetic construct
  misc_feature 1..9876: note = derived and/or modified CDS sequence (opt2) from DENV-2__FJ744724__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatcgtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccgtcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11980 - RNA, 9876 nt, synthetic construct
  misc_feature 1..9876: note = derived and/or modified CDS sequence (opt2) from DENV-2__FJ906957__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgcctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11981 - RNA, 9876 nt, synthetic construct
  misc_feature 1..9876: note = derived and/or modified CDS sequence (opt2) from DENV-2__FJ906958__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaaggtccccttcgagatcatggacctcgagaagcgctacgtcctcggccgcctcatcaccgtcaaccccgtcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccgtcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccagggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgccaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11982 - RNA, 9876 nt, synthetic construct
  misc_feature 1..9876: note = derived and/or modified CDS sequence (opt2) from DENV-2__FJ898452__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11983 - RNA, 9876 nt, synthetic construct
  misc_feature 1..9876: note = derived and/or modified CDS sequence (opt2) from DENV-2__GQ868591__SS-prME
  source 1..9876: mol_type = other RNA
tccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcaccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgctacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcgccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccatcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11984 - RNA, 9876 nt, synthetic construct
  misc_feature 1..9876: note = derived and/or modified CDS sequence (opt2) from DENV-2__GQ868542__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggcggcatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcaccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgactcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11985 - RNA, 9876 nt, synthetic construct
  misc_feature 1..9876: note = derived and/or modified CDS sequence (opt2) from DENV-2__GQ868544__SS-prME
  source 1..9876: mol_type = other RNA
tccgtcggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaaggtccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccagggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctctacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11986 - RNA, 9876 nt, synthetic construct
  misc_feature 1..9876: note = derived and/or modified CDS sequence (opt2) from DENV-2__GQ868545__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatcgtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccgtcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccctcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcgacatggagaagtaccagctcgccgtcaccatcatggccaccctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgacatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaagctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11987 - RNA, 9876 nt, synthetic construct
  misc_feature 1..9876: note = derived and/or modified CDS sequence (opt2) from DENV-2__GQ868543__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcatgttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgtcaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 11988 - RNA, 9876 nt, synthetic construct
  misc_feature 1..9876: note = derived and/or modified CDS sequence (opt2) from DENV-2__EU482544__SS-prME
  source 1..9876: mol_type = other RNA
accgccggcgtcatcatcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11989 - RNA, 9876 nt, synthetic construct
  misc_feature 1..9876: note = derived and/or modified CDS sequence (opt2) from DENV-2__EU482545__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcatgatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatccgcaacgaggaggaggagcagaccctcaccatcctcatccgcaccggcctcctcgtcatctccggcgtcttccccgtctccatccccgtcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 11990 - RNA, 9876 nt, synthetic construct
  misc_feature 1..9876: note = derived and/or modified CDS sequence (opt2) from DENV-2__EU482546__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcatcaacatgtgcaccctcatggccatcgacctcggcgagctctgcgaggacaccatcacctacaagtgccccctcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgccttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaaccaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcttcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcgtctgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatctcccaggtccgctccctcatcggcaacgaggagtacaccgactacatgccctccatgaagcgcttccgccgcgaggaggaggaggccggcgtcctctggtga

SEQ ID NO: 11991 - RNA, 9876 nt, synthetic construct
  misc_feature 1..9876: note = derived and/or modified CDS sequence (opt2) from DENV-2__EU482550__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgctcccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagaccctcgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11992 - RNA, 9876 nt, synthetic construct
  misc_feature 1..9876: note = derived and/or modified CDS sequence (opt2) from DENV-2__EU482551__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccaccatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11993 - RNA, 9876 nt, synthetic construct
  misc_feature 1..9876: note = derived and/or modified CDS sequence (opt2) from DENV-2__EU482552__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccaccggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggctacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11994 - RNA, 9876 nt, synthetic construct
  misc_feature 1..9876: note = derived and/or modified CDS sequence (opt2) from DENV-2__EU482554__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaccgtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgctcccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagaccctcgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11995 - RNA, 9876 nt, synthetic construct
  misc_feature 1..9876: note = derived and/or modified CDS sequence (opt2) from DENV-2__EU482556__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgtctcccacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccgtcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccctcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgtccgcgtcggccgcgagcgcctctcccgcatggccgtctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11996 - RNA, 9876 nt, synthetic construct
  misc_feature 1..9876: note = derived and/or modified CDS sequence (opt2) from DENV-2__EU529693__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccaccatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11997 - RNA, 9876 nt, synthetic construct
  misc_feature 1..9876: note = derived and/or modified CDS sequence (opt2) from DENV-2__EU482557__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 11998 - RNA, 9876 nt, synthetic construct
  misc_feature 1..9876: note = derived and/or modified CDS sequence (opt2) from DENV-2__EU482560__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcatcaacatgtgcaccctcatggccatcgacctcggcgagctctgcgaggacaccatcacctacaagtgccccctcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgccttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaaccaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccctcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcttcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgagaacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcgtctgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatctcccaggtccgctccctcatcggcaacgaggagtacaccgactacatgccctccatgaagcgcttccgccgcgaggaggaggaggccggcgtcctctggtga

SEQ ID NO: 11999 - RNA, 9876 nt, synthetic construct
  misc_feature 1..9876: note = derived and/or modified CDS sequence (opt2) from DENV-2__EU482561__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgtcgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12000 - RNA, 9876 nt, synthetic construct
  misc_feature 1..9876: note = derived and/or modified CDS sequence (opt2) from DENV-2__EU569703__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12001 - RNA, 9876 nt, synthetic construct
  misc_feature 1..9876: note = derived and/or modified CDS sequence (opt2) from DENV-2__EU529694__SS-prME
  source 1..9876: mol_type = other RNA
accgccggcgtcttcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12002 - RNA, 9876 nt, synthetic construct
  misc_feature 1..9876: note = derived and/or modified CDS sequence (opt2) from DENV-2__EU529695__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12003 - RNA, 9876 nt, synthetic construct
  misc_feature 1..9876: note = derived and/or modified CDS sequence (opt2) from DENV-2__EU482562__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcatcctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctccttcatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12004 - RNA, 9876 nt, synthetic construct
  misc_feature 1..9876: note = derived and/or modified CDS sequence (opt2) from DENV-2__EU482565__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacatcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccccccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacgtcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12005 - RNA, 9876 nt, synthetic construct
  misc_feature 1..9876: note = derived and/or modified CDS sequence (opt2) from DENV-2__EU529700__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacctcgagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12006 - RNA, 9876 nt, synthetic construct
  misc_feature 1..9876: note = derived and/or modified CDS sequence (opt2) from DENV-2__EU529701__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccaggtcttcggcgccatctacggcgccgccttctccggcgtctcctggaccatgaagatcttcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12007 - RNA, 9876 nt, synthetic construct
  misc_feature 1..9876: note = derived and/or modified CDS sequence (opt2) from DENV-2__EU569704__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12008 - RNA, 9876 nt, synthetic construct
  misc_feature 1..9876: note = derived and/or modified CDS sequence (opt2) from DENV-2__EU482568__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcgtcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtgggccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12009 - RNA, 9876 nt, synthetic construct
  misc_feature 1..9876: note = derived and/or modified CDS sequence (opt2) from DENV-2__EU482569__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcatccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12010 - RNA, 9876 nt, synthetic construct
  misc_feature 1..9876: note = derived and/or modified CDS sequence (opt2) from DENV-2__EU482570__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcaggtcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtcggctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctcaaggacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggtcatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12011 - RNA, 9876 nt, synthetic construct
  misc_feature 1..9876: note = derived and/or modified CDS sequence (opt2) from DENV-2__EU482571__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgcctggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12012 - RNA, 9876 nt, synthetic construct
  misc_feature 1..9876: note = derived and/or modified CDS sequence (opt2) from DENV-2__EU482572__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcaggtcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccggcgactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcatgatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgaggccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggtcatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12013 - RNA, 9876 nt, synthetic construct
  misc_feature 1..9876: note = derived and/or modified CDS sequence (opt2) from DENV-2__EU482573__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12014 - RNA, 9876 nt, synthetic construct
  misc_feature 1..9876: note = derived and/or modified CDS sequence (opt2) from DENV-2__EU482574__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccacatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12015 - RNA, 9876 nt, synthetic construct
  misc_feature 1..9876: note = derived and/or modified CDS sequence (opt2) from DENV-2__EU482575__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcgccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12016 - RNA, 9876 nt, synthetic construct
  misc_feature 1..9876: note = derived and/or modified CDS sequence (opt2) from DENV-2__EU482578__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12017 - RNA, 9876 nt, synthetic construct
  misc_feature 1..9876: note = derived and/or modified CDS sequence (opt2) from DENV-2__EU482580__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcttcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12018 - RNA, 9876 nt, synthetic construct
  misc_feature 1..9876: note = derived and/or modified CDS sequence (opt2) from DENV-2__EU482581__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12019 - RNA, 9876 nt, synthetic construct
  misc_feature 1..9876: note = derived and/or modified CDS sequence (opt2) from DENV-2__EU482582__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccaaccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgtcttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccaccaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctccaccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12020 - RNA, 9876 nt, synthetic construct
  misc_feature 1..9876: note = derived and/or modified CDS sequence (opt2) from DENV-2__EU482583__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacgccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12021 - RNA, 9876 nt, synthetic construct
  misc_feature 1..9876: note = derived and/or modified CDS sequence (opt2) from DENV-2__EU482585__SS-prME
  source 1..9876: mol_type = other RNA
accgccggcgtcatcatcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcggcatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatggtcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaactccaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12022 - RNA, 9876 nt, synthetic construct
  misc_feature 1..9876: note = derived and/or modified CDS sequence (opt2) from DENV-2__EU482587__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggtcgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtcccgcgagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccgcaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagatcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12023 - RNA, 9876 nt, synthetic construct
  misc_feature 1..9876: note = derived and/or modified CDS sequence (opt2) from DENV-2__EU482588__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaaggtccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12024 - RNA, 9876 nt, synthetic construct
  misc_feature 1..9876: note = derived and/or modified CDS sequence (opt2) from DENV-2__EU569705__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcgtcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12025 - RNA, 9876 nt, synthetic construct
  misc_feature 1..9876: note = derived and/or modified CDS sequence (opt2) from DENV-2__EU482589__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcatgggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacctcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcgtcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12026 - RNA, 9876 nt, synthetic construct
  misc_feature 1..9876: note = derived and/or modified CDS sequence (opt2) from DENV-2__EU569706__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacctcgagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12027 - RNA, 9876 nt, synthetic construct
  misc_feature 1..9876: note = derived and/or modified CDS sequence (opt2) from DENV-2__EU569707__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcgtcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccgcatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12028 - RNA, 9876 nt, synthetic construct
  misc_feature 1..9876: note = derived and/or modified CDS sequence (opt2) from DENV-2__EU660399__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgccagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagaagtacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12029 - RNA, 9876 nt, synthetic construct
  misc_feature 1..9876: note = derived and/or modified CDS sequence (opt2) from DENV-2__EU569708__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatcaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccgtcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagcgcatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccgtcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgccgcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12030 - RNA, 9876 nt, synthetic construct
  misc_feature 1..9876: note = derived and/or modified CDS sequence (opt2) from DENV-2__EU569709__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12031 - RNA, 9876 nt, synthetic construct
  misc_feature 1..9876: note = derived and/or modified CDS sequence (opt2) from DENV-2__EU596485__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgactcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12032 - RNA, 9876 nt, synthetic construct
  misc_feature 1..9876: note = derived and/or modified CDS sequence (opt2) from DENV-2__EU569710__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcaccttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccatcctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12033 - RNA, 9876 nt, synthetic construct
  misc_feature 1..9876: note = derived and/or modified CDS sequence (opt2) from DENV-2__EU596486__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgctcccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacatcgactacatgccctccatgaagcgcttccgcaaggaggaggaggaggccggcgtcctctggtga

SEQ ID NO: 12034 - RNA, 9876 nt, synthetic construct
  misc_feature 1..9876: note = derived and/or modified CDS sequence (opt2) from DENV-2__EU687212__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcatcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatgcccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccgtccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12035 - RNA, 9876 nt, synthetic construct
  misc_feature 1..9876: note = derived and/or modified CDS sequence (opt2) from DENV-2__EU660400__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccaccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccgccagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12036 - RNA, 9876 nt, synthetic construct
  misc_feature 1..9876: note = derived and/or modified CDS sequence (opt2) from DENV-2__EU569711__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacatcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12037 - RNA, 9876 nt, synthetic construct
  misc_feature 1..9876: note = derived and/or modified CDS sequence (opt2) from DENV-2__EU569712__SS-prME
  source 1..9876: mol_type = other RNA
accgccggcatgatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccgcaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12038 - RNA, 9876 nt, synthetic construct
  misc_feature 1..9876: note = derived and/or modified CDS sequence (opt2) from DENV-2__EU596487__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12039 - RNA, 9876 nt, synthetic construct
  misc_feature 1..9876: note = derived and/or modified CDS sequence (opt2) from DENV-2__EU569713__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggctccgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggccaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttctacaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggagaaggccggcgtcctctggtga

SEQ ID NO: 12040 - RNA, 9876 nt, synthetic construct
  misc_feature 1..9876: note = derived and/or modified CDS sequence (opt2) from DENV-2__EU569714__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgtcatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12041 - RNA, 9876 nt, synthetic construct
  misc_feature 1..9876: note = derived and/or modified CDS sequence (opt2) from DENV-2__EU569715__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccacccccggcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12042 - RNA, 9876 nt, synthetic construct
  misc_feature 1..9876: note = derived and/or modified CDS sequence (opt2) from DENV-2__EU569716__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcatctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgctcccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12043 - RNA, 9876 nt, synthetic construct
  misc_feature 1..9876: note = derived and/or modified CDS sequence (opt2) from DENV-2__EU569717__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcgtcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12044 - RNA, 9876 nt, synthetic construct
  misc_feature 1..9876: note = derived and/or modified CDS sequence (opt2) from DENV-2__EU569718__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagtacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacgtcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12045 - RNA, 9876 nt, synthetic construct
  misc_feature 1..9876: note = derived and/or modified CDS sequence (opt2) from DENV-2__EU596488__SS-prME
  source 1..9876: mol_type = other RNA
accgccggcgtcatcatcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccatcaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12046 - RNA, 9876 nt, synthetic construct
  misc_feature 1..9876: note = derived and/or modified CDS sequence (opt2) from DENV-2__EU596489__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccaccatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagttcccctccaagctcgcctccgccatcaagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12047 - RNA, 9876 nt, synthetic construct
  misc_feature 1..9876: note = derived and/or modified CDS sequence (opt2) from DENV-2__EU596490__SS-prME
  source 1..9876: mol_type = other RNA
accgccggcgtcatcatcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacgtcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12048 - RNA, 9876 nt, synthetic construct
  misc_feature 1..9876: note = derived and/or modified CDS sequence (opt2) from DENV-2__EU596491__SS-prME
  source 1..9876: mol_type = other RNA
accgccggcgtcatcatcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggacgcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccaccctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcccacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12049 - RNA, 9876 nt, synthetic construct
  misc_feature 1..9876: note = derived and/or modified CDS sequence (opt2) from DENV-2__EU677141__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12050 - RNA, 9876 nt, synthetic construct
  misc_feature 1..9876: note = derived and/or modified CDS sequence (opt2) from DENV-2__EU677144__SS-prME
  source 1..9876: mol_type = other RNA
accgccggcatgatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggcctcaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccatggagaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccgcaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12051 - RNA, 9876 nt, synthetic construct
  misc_feature 1..9876: note = derived and/or modified CDS sequence (opt2) from DENV-2__EU677145__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcatcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatgcccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccgtccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12052 - RNA, 9876 nt, synthetic construct
  misc_feature 1..9876: note = derived and/or modified CDS sequence (opt2) from DENV-2__EU677146__SS-prME
  source 1..9876: mol_type = other RNA
accgtcggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggccaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12053 - RNA, 9876 nt, synthetic construct
  misc_feature 1..9876: note = derived and/or modified CDS sequence (opt2) from DENV-2__EU687214__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccaacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcatcgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12054 - RNA, 9876 nt, synthetic construct
  misc_feature 1..9876: note = derived and/or modified CDS sequence (opt2) from DENV-2__EU687215__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaagaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccgccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12055 - RNA, 9876 nt, synthetic construct
  misc_feature 1..9876: note = derived and/or modified CDS sequence (opt2) from DENV-2__EU687216__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcaacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgagctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12056 - RNA, 9876 nt, synthetic construct
  misc_feature 1..9876: note = derived and/or modified CDS sequence (opt2) from DENV-2__EU726770__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcaccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12057 - RNA, 9876 nt, synthetic construct
  misc_feature 1..9876: note = derived and/or modified CDS sequence (opt2) from DENV-2__EU781135__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12058 - RNA, 9876 nt, synthetic construct
  misc_feature 1..9876: note = derived and/or modified CDS sequence (opt2) from DENV-2__EU687222__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12059 - RNA, 9876 nt, synthetic construct
  misc_feature 1..9876: note = derived and/or modified CDS sequence (opt2) from DENV-2__EU687223__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgccttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12060 - RNA, 9876 nt, synthetic construct
  misc_feature 1..9876: note = derived and/or modified CDS sequence (opt2) from DENV-2__EU687227__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccagatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12061 - RNA, 9876 nt, synthetic construct
  misc_feature 1..9876: note = derived and/or modified CDS sequence (opt2) from DENV-2__EU687228__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaacgagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12062 - RNA, 9876 nt, synthetic construct
  misc_feature 1..9876: note = derived and/or modified CDS sequence (opt2) from DENV-2__EU687230__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgcggcacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12063 - RNA, 9876 nt, synthetic construct
  misc_feature 1..9876: note = derived and/or modified CDS sequence (opt2) from DENV-2__EU687231__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaacatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12064 - RNA, 9876 nt, synthetic construct
  misc_feature 1..9876: note = derived and/or modified CDS sequence (opt2) from DENV-2__EU687199__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatgatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12065 - RNA, 9876 nt, synthetic construct
  misc_feature 1..9876: note = derived and/or modified CDS sequence (opt2) from DENV-2__EU687235__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctccccccccctcgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12066 - RNA, 9876 nt, synthetic construct
  misc_feature 1..9876: note = derived and/or modified CDS sequence (opt2) from DENV-2__EU687236__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12067 - RNA, 9876 nt, synthetic construct
  misc_feature 1..9876: note = derived and/or modified CDS sequence (opt2) from DENV-2__EU687237__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12068 - RNA, 9876 nt, synthetic construct
  misc_feature 1..9876: note = derived and/or modified CDS sequence (opt2) from DENV-2__EU687238__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcaccatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12069 - RNA, 9876 nt, synthetic construct
  misc_feature 1..9876: note = derived and/or modified CDS sequence (opt2) from DENV-2__EU687240__SS-prME
  source 1..9876: mol_type = other RNA
accgtcggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggccaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12070 - RNA, 9876 nt, synthetic construct
  misc_feature 1..9876: note = derived and/or modified CDS sequence (opt2) from DENV-2__EU687241__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctactccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcaccaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaccatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcgtcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12071 - RNA, 9876 nt, synthetic construct
  misc_feature 1..9876: note = derived and/or modified CDS sequence (opt2) from DENV-2__EU687242__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctcaacgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12072 - RNA, 9876 nt, synthetic construct
  misc_feature 1..9876: note = derived and/or modified CDS sequence (opt2) from DENV-2__EU687243__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctcaacgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12073 - RNA, 9876 nt, synthetic construct
  misc_feature 1..9876: note = derived and/or modified CDS sequence (opt2) from DENV-2__EU687245__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctcaacgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacgcccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccacctcccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccgtcaaccaggtccgctccctcatcggcaacgaggagtacaccgactacatgccctccatgaagcgcttccgcaaggaggaggaggaggccggcgtcctctggtga

SEQ ID NO: 12074 - RNA, 9873 nt, synthetic construct
  misc_feature 1..9873: note = derived and/or modified CDS sequence (opt2) from DENV-2__HQ541798__SS-prME
  source 1..9873: mol_type = other RNA
accgccggcatgatcttcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagtccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaaggacatgaagggcgaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgctcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagccccacaccctctggtccaacgaggtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccctccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctctccctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccgccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12075 - RNA, 9876 nt, synthetic construct
  misc_feature 1..9876: note = derived and/or modified CDS sequence (opt2) from DENV-2__JF730053__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccggcgacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagtccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgctcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacgaggtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccctccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctctccctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccgccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12076 - RNA, 9876 nt, synthetic construct
  misc_feature 1..9876: note = derived and/or modified CDS sequence (opt2) from DENV-2__EU529706__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggccgcaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga
